United States Patent 8,268,964 (MHC PEPTIDE COMPLEXES AND USES THEREOF IN INFECTIOUS DISEASES) - sequence listing, part 3

SEQ ID NO: 61175 - protein, 9 aa, BK Virus
IFFLTPHRH

SEQ ID NO: 61176 - protein, 15 aa, BK Virus
ARFVRQIDFRPKIYL

SEQ ID NO: 61177 - protein, 9 aa, BK Virus
VRQIDFRPK

SEQ ID NO: 61178 - protein, 15 aa, BK Virus
LLLLLIWFRPVADFS

SEQ ID NO: 61179 - protein, 9 aa, BK Virus
LIWFRPVAD

SEQ ID NO: 61180 - protein, 15 aa, BK Virus
CAGHNIIFFLTPHRH

SEQ ID NO: 61181 - protein, 9 aa, BK Virus
IIFFLTPHR

SEQ ID NO: 61182 - protein, 15 aa, BK Virus
TFSRMKYNICMGKCI

SEQ ID NO: 61183 - protein, 9 aa, BK Virus
FSRMKYNIC

SEQ ID NO: 61184 - protein, 15 aa, BK Virus
RFVRQIDFRPKIYLR

SEQ ID NO: 61185 - protein, 9 aa, BK Virus
VRQIDFRPK

SEQ ID NO: 61186 - protein, 15 aa, BK Virus
LLLLIWFRPVADFSK

SEQ ID NO: 61187 - protein, 9 aa, BK Virus
LIWFRPVAD

SEQ ID NO: 61188 - protein, 15 aa, BK Virus
FSRMKYNICMGKCIL

SEQ ID NO: 61189 - protein, 9 aa, BK Virus
FSRMKYNIC

SEQ ID NO: 61190 - protein, 15 aa, BK Virus
LLLIWFRPVADFSKD

SEQ ID NO: 61191 - protein, 9 aa, BK Virus
LIWFRPVAD

SEQ ID NO: 61192 - protein, 15 aa, BK Virus
LQARFVRQIDFRPKI

SEQ ID NO: 61193 - protein, 9 aa, BK Virus
VRQIDFRPK

SEQ ID NO: 61194 - protein, 15 aa, BK Virus
MTLLLLLIWFRPVAD

SEQ ID NO: 61195 - protein, 9 aa, BK Virus
LLLIWFRPV

SEQ ID NO: 61196 - protein, 15 aa, BK Virus
TLQARFVRQIDFRPK

SEQ ID NO: 61197 - protein, 9 aa, BK Virus
FVRQIDFRP

SEQ ID NO: 61198 - protein, 15 aa, BK Virus
QARFVRQIDFRPKIY

SEQ ID NO: 61199 - protein, 9 aa, BK Virus
VRQIDFRPK

SEQ ID NO: 61200 - protein, 15 aa, BK Virus
FVRQIDFRPKIYLRK

SEQ ID NO: 61201 - protein, 9 aa, BK Virus
RQIDFRPKI

SEQ ID NO: 61202 - protein, 15 aa, BK Virus
VRQIDFRPKIYLRKS

SEQ ID NO: 61203 - protein, 9 aa, BK Virus
FRPKIYLRK

SEQ ID NO: 61204 - protein, 15 aa, BK Virus
RQIDFRPKIYLRKSL

SEQ ID NO: 61205 - protein, 9 aa, BK Virus
FRPKIYLRK

SEQ ID NO: 61206 - protein, 15 aa, BK Virus
QIDFRPKIYLRKSLQ

SEQ ID NO: 61207 - protein, 9 aa, BK Virus
FRPKIYLRK

SEQ ID NO: 61208 - protein, 15 aa, BK Virus
IDFRPKIYLRKSLQN

SEQ ID NO: 61209 - protein, 9 aa, BK Virus
FRPKIYLRK

SEQ ID NO: 61210 - protein, 15 aa, BK Virus
LHCVVFNVPKRRYWL

SEQ ID NO: 61211 - protein, 9 aa, BK Virus
VVFNVPKRR

SEQ ID NO: 61212 - protein, 15 aa, BK Virus
HCVVFNVPKRRYWLF

SEQ ID NO: 61213 - protein, 9 aa, BK Virus
VVFNVPKRR

SEQ ID NO: 61214 - protein, 15 aa, BK Virus
FLHCVVFNVPKRRYW

SEQ ID NO: 61215 - protein, 9 aa, BK Virus
VVFNVPKRR

SEQ ID NO: 61216 - protein, 15 aa, BK Virus
DFLHCVVFNVPKRRY

SEQ ID NO: 61217 - protein, 9 aa, BK Virus
VVFNVPKRR

SEQ ID NO: 61218 - protein, 15 aa, BK Virus
DFRPKIYLRKSLQNS

SEQ ID NO: 61219 - protein, 9 aa, BK Virus
FRPKIYLRK

SEQ ID NO: 61220 - protein, 15 aa, BK Virus
FRPKIYLRKSLQNSE

SEQ ID NO: 61221 - protein, 9 aa, BK Virus
FRPKIYLRK

SEQ ID NO: 61222 - protein, 15 aa, BK Virus
KEHDFNPEEPEETKQ

SEQ ID NO: 61223 - protein, 9 aa, BK Virus
FNPEEPEET

SEQ ID NO: 61224 - protein, 15 aa, BK Virus
LKEHDFNPEEPEETK

SEQ ID NO: 61225 - protein, 9 aa, BK Virus
FNPEEPEET

SEQ ID NO: 61226 - protein, 15 aa, BK Virus
EHDFNPEEPEETKQV

SEQ ID NO: 61227 - protein, 9 aa, BK Virus
FNPEEPEET

SEQ ID NO: 61228 - protein, 15 aa, BK Virus
GLKEHDFNPEEPEET

SEQ ID NO: 61229 - protein, 9 aa, BK Virus
GLKEHDFNP

SEQ ID NO: 61230 - protein, 15 aa, BK Virus
HDFNPEEPEETKQVS

SEQ ID NO: 61231 - protein, 9 aa, BK Virus
FNPEEPEET

SEQ ID NO: 61232 - protein, 15 aa, BK Virus
FDFLHCVVFNVPKRR

SEQ ID NO: 61233 - protein, 9 aa, BK Virus
CVVFNVPKR

SEQ ID NO: 61234 - protein, 15 aa, BK Virus
CVVFNVPKRRYWLFK

SEQ ID NO: 61235 - protein, 9 aa, BK Virus
VVFNVPKRR

SEQ ID NO: 61236 - protein, 15 aa, BK Virus
TYGTEEWESWWSSFN

SEQ ID NO: 61237 - protein, 9 aa, BK Virus
TEEWESWWS

SEQ ID NO: 61238 - protein, 15 aa, BK Virus
YGTEEWESWWSSFNE

SEQ ID NO: 61239 - protein, 9 aa, BK Virus
WESWWSSFN

SEQ ID NO: 61240 - protein, 15 aa, BK Virus
EEWESWWSSFNEKWD

SEQ ID NO: 61241 - protein, 9 aa, BK Virus
WESWWSSFN

SEQ ID NO: 61242 - protein, 15 aa, BK Virus
TEEWESWWSSFNEKW

SEQ ID NO: 61243 - protein, 9 aa, BK Virus
WESWWSSFN

SEQ ID NO: 61244 - protein, 15 aa, BK Virus
GTEEWESWWSSFNEK

SEQ ID NO: 61245 - protein, 9 aa, BK Virus
WESWWSSFN

SEQ ID NO: 61246 - protein, 15 aa, BK Virus
KGFQCFKRPKTPPPK

SEQ ID NO: 61247 - protein, 9 aa, BK Virus
FQCFKRPKT

SEQ ID NO: 61248 - protein, 15 aa, BK Virus
EDKMKRMNTLYKKME

SEQ ID NO: 61249 - protein, 9 aa, BK Virus
MKRMNTLYK

SEQ ID NO: 61250 - protein, 15 aa, BK Virus
DKMKRMNTLYKKMEQ

SEQ ID NO: 61251 - protein, 9 aa, BK Virus
MKRMNTLYK

SEQ ID NO: 61252 - protein, 15 aa, BK Virus
DEDKMKRMNTLYKKM

SEQ ID NO: 61253 - protein, 9 aa, BK Virus
MKRMNTLYK

SEQ ID NO: 61254 - protein, 15 aa, BK Virus
VVFNVPKRRYWLFKG

SEQ ID NO: 61255 - protein, 9 aa, BK Virus
VVFNVPKRR

SEQ ID NO: 61256 - protein, 15 aa, BK Virus
GDEDKMKRMNTLYKK

SEQ ID NO: 61257 - protein, 9 aa, BK Virus
MKRMNTLYK

SEQ ID NO: 61258 - protein, 15 aa, BK Virus
HNIIFFLTPHRHRVS

SEQ ID NO: 61259 - protein, 9 aa, BK Virus
FFLTPHRHR

SEQ ID NO: 61260 - protein, 15 aa, BK Virus
GGDEDKMKRMNTLYK

SEQ ID NO: 61261 - protein, 9 aa, BK Virus
DKMKRMNTL

SEQ ID NO: 61262 - protein, 15 aa, BK Virus
GHNIIFFLTPHRHRV

SEQ ID NO: 61263 - protein, 9 aa, BK Virus
FFLTPHRHR

SEQ ID NO: 61264 - protein, 15 aa, BK Virus
NIIFFLTPHRHRVSA

SEQ ID NO: 61265 - protein, 9 aa, BK Virus
FFLTPHRHR

SEQ ID NO: 61266 - protein, 15 aa, BK Virus
TADSQHSTPPKKKRK

SEQ ID NO: 61267 - protein, 9 aa, BK Virus
QHSTPPKKK

SEQ ID NO: 61268 - protein, 15 aa, BK Virus
ADSQHSTPPKKKRKV

SEQ ID NO: 61269 - protein, 9 aa, BK Virus
QHSTPPKKK

SEQ ID NO: 61270 - protein, 15 aa, BK Virus
FNPEEPEETKQVSWK

SEQ ID NO: 61271 - protein, 9 aa, BK Virus
FNPEEPEET

SEQ ID NO: 61272 - protein, 15 aa, BK Virus
KRMNTLYKKMEQDVK

SEQ ID NO: 61273 - protein, 9 aa, BK Virus
KRMNTLYKK

SEQ ID NO: 61274 - protein, 15 aa, BK Virus
AAWGNLPLMRKAYLK

SEQ ID NO: 61275 - protein, 9 aa, BK Virus
WGNLPLMRK

SEQ ID NO: 61276 - protein, 15 aa, BK Virus
LVVLRQLSRQASVKV

SEQ ID NO: 61277 - protein, 9 aa, BK Virus
LRQLSRQAS

SEQ ID NO: 61278 - protein, 15 aa, BK Virus
VVLRQLSRQASVKVG

SEQ ID NO: 61279 - protein, 9 aa, BK Virus
LSRQASVKV

SEQ ID NO: 61280 - protein, 15 aa, BK Virus
VLRQLSRQASVKVGK

SEQ ID NO: 61281 - protein, 9 aa, BK Virus
LSRQASVKV

SEQ ID NO: 61282 - protein, 15 aa, BK Virus
LRQLSRQASVKVGKT

SEQ ID NO: 61283 - protein, 9 aa, BK Virus
LSRQASVKV

SEQ ID NO: 61284 - protein, 15 aa, BK Virus
PKNLVVLRQLSRQAS

SEQ ID NO: 61285 - protein, 9 aa, BK Virus
VLRQLSRQA

SEQ ID NO: 61286 - protein, 15 aa, BK Virus
NLVVLRQLSRQASVK

SEQ ID NO: 61287 - protein, 9 aa, BK Virus
VLRQLSRQA

SEQ ID NO: 61288 - protein, 15 aa, BK Virus
KNLVVLRQLSRQASV

SEQ ID NO: 61289 - protein, 9 aa, BK Virus
VLRQLSRQA

SEQ ID NO: 61290 - protein, 15 aa, BK Virus
RQLSRQASVKVGKTW

SEQ ID NO: 61291 - protein, 9 aa, BK Virus
LSRQASVKV

SEQ ID NO: 61292 - protein, 15 aa, BK Virus
LSRQASVKVGKTWTG

SEQ ID NO: 61293 - protein, 9 aa, BK Virus
LSRQASVKV

SEQ ID NO: 61294 - protein, 15 aa, BK Virus
ASVKVGKTWTGTKKR

SEQ ID NO: 61295 - protein, 9 aa, BK Virus
VKVGKTWTG

SEQ ID NO: 61296 - protein, 15 aa, BK Virus
QASVKVGKTWTGTKK

SEQ ID NO: 61297 - protein, 9 aa, BK Virus
VKVGKTWTG

SEQ ID NO: 61298 - protein, 15 aa, BK Virus
SRQASVKVGKTWTGT

SEQ ID NO: 61299 - protein, 9 aa, BK Virus
VKVGKTWTG

SEQ ID NO: 61300 - protein, 15 aa, BK Virus
RQASVKVGKTWTGTK

SEQ ID NO: 61301 - protein, 9 aa, BK Virus
VKVGKTWTG

SEQ ID NO: 61302 - protein, 15 aa, BK Virus
EPKNLVVLRQLSRQA

SEQ ID NO: 61303 - protein, 9 aa, BK Virus
PKNLVVLRQ

SEQ ID NO: 61304 - protein, 15 aa, BK Virus
QLSRQASVKVGKTWT

SEQ ID NO: 61305 - protein, 9 aa, BK Virus
LSRQASVKV

SEQ ID NO: 61306 - protein, 15 aa, BK Virus
SVKVGKTWTGTKKRA

SEQ ID NO: 61307 - protein, 9 aa, BK Virus
VKVGKTWTG

SEQ ID NO: 61308 - protein, 15 aa, BK Virus
VKVGKTWTGTKKRAQ

SEQ ID NO: 61309 - protein, 9 aa, BK Virus
VKVGKTWTG

SEQ ID NO: 61310 - protein, 15 aa, BK Virus
LVVLRQLSRQASVKV

SEQ ID NO: 61311 - protein, 9 aa, BK Virus
VLRQLSRQA

SEQ ID NO: 61312 - protein, 15 aa, BK Virus
VLRQLSRQASVKVGK

SEQ ID NO: 61313 - protein, 9 aa, BK Virus
LSRQASVKV

SEQ ID NO: 61314 - protein, 15 aa, BK Virus
VVLRQLSRQASVKVG

SEQ ID NO: 61315 - protein, 9 aa, BK Virus
LSRQASVKV

SEQ ID NO: 61316 - protein, 15 aa, BK Virus
LRQLSRQASVKVGKT

SEQ ID NO: 61317 - protein, 9 aa, BK Virus
LSRQASVKV

SEQ ID NO: 61318 - protein, 15 aa, BK Virus
RQLSRQASVKVGKTW

SEQ ID NO: 61319 - protein, 9 aa, BK Virus
LSRQASVKV

SEQ ID NO: 61320 - protein, 15 aa, BK Virus
DGKNKSTTALPAVKD

SEQ ID NO: 61321 - protein, 9 aa, BK Virus
NKSTTALPA

SEQ ID NO: 61322 - protein, 15 aa, BK Virus
GKNKSTTALPAVKDS

SEQ ID NO: 61323 - protein, 9 aa, BK Virus
TTALPAVKD

SEQ ID NO: 61324 - protein, 15 aa, BK Virus
KNKSTTALPAVKDSV

SEQ ID NO: 61325 - protein, 9 aa, BK Virus
TTALPAVKD

SEQ ID NO: 61326 - protein, 15 aa, BK Virus
NKSTTALPAVKDSVK

SEQ ID NO: 61327 - protein, 9 aa, BK Virus
TTALPAVKD

SEQ ID NO: 61328 - protein, 15 aa, BK Virus
LVVLRQLSRQASVKV

SEQ ID NO: 61329 - protein, 9 aa, BK Virus
LRQLSRQAS

SEQ ID NO: 61330 - protein, 15 aa, BK Virus
PKNLVVLRQLSRQAS

SEQ ID NO: 61331 - protein, 9 aa, BK Virus
PKNLVVLRQ

SEQ ID NO: 61332 - protein, 15 aa, BK Virus
KNLVVLRQLSRQASV

SEQ ID NO: 61333 - protein, 9 aa, BK Virus
LRQLSRQAS

SEQ ID NO: 61334 - protein, 15 aa, BK Virus
VVLRQLSRQASVKVG

SEQ ID NO: 61335 - protein, 9 aa, BK Virus
LRQLSRQAS

SEQ ID NO: 61336 - protein, 15 aa, BK Virus
NLVVLRQLSRQASVK

SEQ ID NO: 61337 - protein, 9 aa, BK Virus
LRQLSRQAS

SEQ ID NO: 61338 - protein, 15 aa, BK Virus
PKNLVVLRQLSRQAS

SEQ ID NO: 61339 - protein, 9 aa, BK Virus
VVLRQLSRQ

SEQ ID NO: 61340 - protein, 15 aa, BK Virus
LVVLRQLSRQASVKV

SEQ ID NO: 61341 - protein, 9 aa, BK Virus
LRQLSRQAS

SEQ ID NO: 61342 - protein, 15 aa, BK Virus
KNLVVLRQLSRQASV

SEQ ID NO: 61343 - protein, 9 aa, BK Virus
LRQLSRQAS

SEQ ID NO: 61344 - protein, 15 aa, BK Virus
VVLRQLSRQASVKVG

SEQ ID NO: 61345 - protein, 9 aa, BK Virus
LRQLSRQAS

SEQ ID NO: 61346 - protein, 15 aa, BK Virus
NLVVLRQLSRQASVK

SEQ ID NO: 61347 - protein, 9 aa, BK Virus
LRQLSRQAS

SEQ ID NO: 61348 - protein, 15 aa, BK Virus
CEPKNLVVLRQLSRQ

SEQ ID NO: 61349 - protein, 9 aa, BK Virus
LVVLRQLSR

SEQ ID NO: 61350 - protein, 15 aa, BK Virus
PKNLVVLRQLSRQAS

SEQ ID NO: 61351 - protein, 9 aa, BK Virus
LVVLRQLSR

SEQ ID NO: 61352 - protein, 15 aa, BK Virus
KNLVVLRQLSRQASV

SEQ ID NO: 61353 - protein, 9 aa, BK Virus
LVVLRQLSR

SEQ ID NO: 61354 - protein, 15 aa, BK Virus
EPKNLVVLRQLSRQA

SEQ ID NO: 61355 - protein, 9 aa, BK Virus
LVVLRQLSR

SEQ ID NO: 61356 - protein, 15 aa, BK Virus
CEPKNLVVLRQLSRQ

SEQ ID NO: 61357 - protein, 9 aa, BK Virus
LVVLRQLSR

SEQ ID NO: 61358 - protein, 15 aa, BK Virus
NLVVLRQLSRQASVK

SEQ ID NO: 61359 - protein, 9 aa, BK Virus
LVVLRQLSR

SEQ ID NO: 61360 - protein, 15 aa, BK Virus
LVVLRQLSRQASVKV

SEQ ID NO: 61361 - protein, 9 aa, BK Virus
LVVLRQLSR

SEQ ID NO: 61362 - protein, 15 aa, BK Virus
FCEPKNLVVLRQLSR

SEQ ID NO: 61363 - protein, 9 aa, BK Virus
NLVVLRQLS

SEQ ID NO: 61364 - protein, 15 aa, BK Virus
VVLRQLSRQASVKVG

SEQ ID NO: 61365 - protein, 9 aa, BK Virus
LRQLSRQAS

SEQ ID NO: 61366 - protein, 15 aa, BK Virus
RIFIFILELLLEFCR

SEQ ID NO: 61367 - protein, 9 aa, BK Virus
ILELLLEFC
